United States Patent 11,752,181 (COMPOSITIONS AND METHODS OF TREATING HUNTINGTON'S DISEASE) - sequence listing, part 2

SEQ ID NO: 1888 - protein, 737 aa, Artificial Sequence
  Description of Artificial Sequence: Synthetic polypeptide
MAADGYLPDWLEDNLSEGIREWWDLKPGAPKPKANQQKQDNGRGLVLPGYKYLGPFNGLDKGEPVNAADAAALEHDKAYDQQLQAGDNPYLRYNHADAEFQERLQEDTSFGGNLGRAVFQAKKRVLEPLGLVESPVKTAPGKKRPVEPSPQRSPDSSTGIGKKGQQPAKKRLNFGQTGDSESVPDPQPIGEPPAAPSGVGPNTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYNFEDVPFHSSYAHSQSLDRLMNPLIDQYLYYLSRTQSTGGTAGTQQLLFSQAGPNNMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGWADNLQQQNAAPIVGAVNSQGALPGMVWQNRDVYLQGPIWAKIPHTDGNFHPSPLMGGFGLKHPPPQILIKNTPVPADPPTTFNQAKLASFITQYSTGQVSVEIEWELQKENSKRWNPEIQYTSNYYKSTNVDFAVNTEGTYSEPRPIGTRYLTRNL

SEQ ID NO: 1889 - DNA, 2211 bp, Artificial Sequence
  Description of Artificial Sequence: Synthetic polynucleotide
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagcgcttcaacgggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacgccaagtctgtcaatgtggactttactgtggacaataatggcgtgtattcagagcctcgccccattggcaccagatacctgactcgtaatctgtaa

SEQ ID NO: 1890 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctgtaa

SEQ ID NO: 1891 - DNA, 2205 bp, Artificial Sequence
  Description of Artificial Sequence: Synthetic polynucleotide
atggctgccgatggttatcttccagattggctcgaggacaacctctdgagggcattcgcgagtggtgggacttgaaacctggagccccgaaacccaaagccaaccagcaaaagcaggacgacggccggggtdggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaaccttttggtdggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaa

SEQ ID NO: 1892 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacgaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaa

SEQ ID NO: 1893 - DNA, 2208 bp, Artificial Sequence
  Description of Artificial Sequence: Synthetic polynucleotide
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacttgagcagaacaaacactccaagtggaaccaccacgcagtcaaggcttcagttttctgtggccggacccagtaacatggctgtccagggaaggaactggcttcctggaccctgttaccgccagcagcgagtatcaaagacatctgcggataacaacaacagtgaatttgcttggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagcaacagaacacagcaccagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaa

SEQ ID NO: 1894 - protein, 735 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSVAGPSNMAVQGRNWLPGPCYRQQRVSKTSADNNNSEFAWTGATKYHLNGRDSLVNPGPAMASHKDDEEKFFPQSGVLIFGKQGSEKTNVDIEKVMITDEEEIRTTNPVATEQYGSVSTNLQQQNTAPATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 1895 - DNA, 2208 bp, Artificial Sequence
  Description of Artificial Sequence: Synthetic polynucleotide
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagaggattcttgaacctctgggcctggttgaggaacctgttaagacggctccgggaaaaaagaggccggtagagcactctcctgcggagccagactcctcctcgggaaccggaaagtcgggccagcagcctgcaagaaaaagattgaattttggtcagactggagacgcagactcagtacctgacccccagcctctcggacagccaccagcagccccctctggtctgggaactaatacgatggcttcaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcagcttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacttgagcagaacaaacactccaagtggaaccaccacgatgtcaaggcttcagttttctcaggccggagcgagtgacattcgggaccagtctaggaactggcttcctggaccctgttaccgccagcagcgagtatcaaagacagctgcggataacaacaacagtgattactcgtggactggagctaccaagtaccacctcaatggcagagactctctggtgaatccgggcccggccatggcaagccacaaggacgatgaagaaaagtattttcctcagagcggggttctcatctttgggaagcaagactcaggaaaaacaaatgtggacattgaaaaggtcatgattacagacgaagaggaaatcaggacaaccaatcccgtggctacggagcagtatggttctgtatctaccaacctccagagcggcaacacacaagcagctacctcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaa

SEQ ID NO: 1896 - DNA, 2208 bp, Artificial Sequence
  Description of Artificial Sequence: Synthetic polynucleotide
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagaggattcttgaacctctgggcctggttgaggaacctgttaagacggctccgggaaaaaagaggccggtagagcactctcctgcggagccagactcctcctcgggaaccggaaagtcgggccagcagcctgcaagaaaaagattgaattttggtcagactggagacgcagactcagtacctgacccccagcctctcggacagccaccagcagccccctctggtctgggaactaatacgatggcttcaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacttgagcagaacaaacactccaagtggaaccaccacgatgtcaaggcttcagttttctcaggccggagcgagtgacattcgggaccagtctaggaactggcttcctggaccctgttaccgccagcagcgagtatcaaagacagctgcggataacaacaacagtgattactcgtggactggagctaccaagtaccacctcaatggcagagactctctggtgaatccgggcccggccatggcaagccacaaggacgatgaagaaaagtattttcctcagagcggggttctcatctttgggaagcaagactcaggaaaaacaaatgtggacattgaaaaggtcatgattacagacgaagaggaaatcaggacaaccaatcccgtggctacggagcagtatggttctgtatctaccaacctccagagcggcaacacacaagcagctacctcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaa

SEQ ID NO: 1897 - protein, 735 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRILEPLGLVEEPVKTAPGKKRPVEHSPAEPDSSSGTGKSGQQPARKRLNFGQTGDADSVPDPQPLGQPPAAPSGLGTNTMASGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTMSRLQFSQAGASDIRDQSRNWLPGPCYRQQRVSKTAADNNNSDYSWTGATKYHLNGRDSLVNPGPAMASHKDDEEKYFPQSGVLIFGKQDSGKTNVDIEKVMITDEEEIRTTNPVATEQYGSVSTNLQSGNTQAATSDVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 1898 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYFLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 1899 - protein, 747 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNAAAGSTPPPMAARQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 1900 - protein, 747 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNAAAGETRAPLAARQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 1901 - protein, 10 aa, Artificial Sequence
  Description of Artificial Sequence: Synthetic polypeptide
VNLTWSRASG

SEQ ID NO: 1902 - protein, 14 aa, Artificial Sequence
  Description of Artificial Sequence: Synthetic polypeptide
EFCINHRGYWVCGD

SEQ ID NO: 1903 - protein, 11 aa, Artificial Sequence
  Description of Artificial Sequence: Synthetic polypeptide
EDGQVMDVDLS

SEQ ID NO: 1904 - protein, 9 aa, Artificial Sequence
  Description of Artificial Sequence: Synthetic polypeptide
EKQRNGTLT

SEQ ID NO: 1905 - protein, 17 aa, Artificial Sequence
  Description of Artificial Sequence: Synthetic polypeptide
TYQCRVTHPHLPRALMR

SEQ ID NO: 1906 - protein, 14 aa, Artificial Sequence
  Description of Artificial Sequence: Synthetic polypeptide
RHSTTQPRKTKGSG

SEQ ID NO: 1907 - protein, 13 aa, Artificial Sequence
  Description of Artificial Sequence: Synthetic polypeptide
DSNPRGVSAYLSR

SEQ ID NO: 1908 - protein, 12 aa, Artificial Sequence
  Description of Artificial Sequence: Synthetic polypeptide
TITCLWDLAPSK

SEQ ID NO: 1909 - protein, 10 aa, Artificial Sequence
  Description of Artificial Sequence: Synthetic polypeptide
KTKGSGFFVF

SEQ ID NO: 1910 - protein, 12 aa, Artificial Sequence
  Description of Artificial Sequence: Synthetic polypeptide
THPHLPRALMRS

SEQ ID NO: 1911 - protein, 23 aa, Artificial Sequence
  Description of Artificial Sequence: Synthetic polypeptide
GETYQCRVTHPHLPRALMRSTTK

SEQ ID NO: 1912 - protein, 8 aa, Artificial Sequence
  Description of Artificial Sequence: Synthetic polypeptide
LPRALMRS

SEQ ID NO: 1913 - protein, 8 aa, Artificial Sequence
  Description of Artificial Sequence: Synthetic polypeptide
INHRGYWV

SEQ ID NO: 1914 - protein, 12 aa, Artificial Sequence
  Description of Artificial Sequence: Synthetic polypeptide
CDAGSVRTNAPD

SEQ ID NO: 1915 - protein, 17 aa, Artificial Sequence
  Description of Artificial Sequence: Synthetic polypeptide
AKAVSNLTESRSESLQS

SEQ ID NO: 1916 - protein, 13 aa, Artificial Sequence
  Description of Artificial Sequence: Synthetic polypeptide
SLTGDEFKKVLET

SEQ ID NO: 1917 - protein, 11 aa, Artificial Sequence
  Description of Artificial Sequence: Synthetic polypeptide
REAVAYRFEED

SEQ ID NO: 1918 - protein, 10 aa, Artificial Sequence
  Description of Artificial Sequence: Synthetic polypeptide
INPEIITLDG

SEQ ID NO: 1919 - protein, 15 aa, Artificial Sequence
  Description of Artificial Sequence: Synthetic polypeptide
DISVTGAPVITATYL

SEQ ID NO: 1920 - protein, 12 aa, Artificial Sequence
  Description of Artificial Sequence: Synthetic polypeptide
DISVTGAPVITA

SEQ ID NO: 1921 - protein, 17 aa, Artificial Sequence
  Description of Artificial Sequence: Synthetic polypeptide
PKTVSNLTESSSESVQS

SEQ ID NO: 1922 - protein, 13 aa, Artificial Sequence
  Description of Artificial Sequence: Synthetic polypeptide
SLMGDEFKAVLET

SEQ ID NO: 1923 - protein, 11 aa, Artificial Sequence
  Description of Artificial Sequence: Synthetic polypeptide
QHSVAYTFEED

SEQ ID NO: 1924 - protein, 10 aa, Artificial Sequence
  Description of Artificial Sequence: Synthetic polypeptide
INPEIITRDG

SEQ ID NO: 1925 - protein, 15 aa, Artificial Sequence
  Description of Artificial Sequence: Synthetic polypeptide
DISLTGDPVITASYL

SEQ ID NO: 1926 - protein, 12 aa, Artificial Sequence
  Description of Artificial Sequence: Synthetic polypeptide
DISLTGDPVITA

SEQ ID NO: 1927 - protein, 11 aa, Artificial Sequence
  Description of Artificial Sequence: Synthetic polypeptide
DQSIDFEIDSA

SEQ ID NO: 1928 - protein, 20 aa, Artificial Sequence
  Description of Artificial Sequence: Synthetic polypeptide
KNVSEDLPLPTFSPTLLGDS

SEQ ID NO: 1929 - protein, 11 aa, Artificial Sequence
  Description of Artificial Sequence: Synthetic polypeptide
KNVSEDLPLPT

SEQ ID NO: 1930 - protein, 12 aa, Artificial Sequence
  Description of Artificial Sequence: Synthetic polypeptide
CDSGRVRTDAPD

SEQ ID NO: 1931 - protein, 14 aa, Artificial Sequence
  Description of Artificial Sequence: Synthetic polypeptide
FPEHLLVDFLQSLS

SEQ ID NO: 1932 - protein, 9 aa, Artificial Sequence
  Description of Artificial Sequence: Synthetic polypeptide
DAEFRHDSG

SEQ ID NO: 1933 - protein, 16 aa, Artificial Sequence
  Description of Artificial Sequence: Synthetic polypeptide
HYAAAQWDFGNTMCQL

SEQ ID NO: 1934 - protein, 13 aa, Artificial Sequence
  Description of Artificial Sequence: Synthetic polypeptide
YAAQWDFGNTMCQ

SEQ ID NO: 1935 - protein, 10 aa, Artificial Sequence
  Description of Artificial Sequence: Synthetic polypeptide
RSQKEGLHYT

SEQ ID NO: 1936 - protein, 19 aa, Artificial Sequence
  Description of Artificial Sequence: Synthetic polypeptide
SSRTPSDKPVAHWANPQAE

SEQ ID NO: 1937 - protein, 15 aa, Artificial Sequence
  Description of Artificial Sequence: Synthetic polypeptide
SRTPSDKPVAHWANP

SEQ ID NO: 1938 - protein, 9 aa, Artificial Sequence
  Description of Artificial Sequence: Synthetic polypeptide
SSRTPSDKP

SEQ ID NO: 1939 - protein, 14 aa, Artificial Sequence
  Description of Artificial Sequence: Synthetic polypeptide
NADGNVDYHMNSVP

SEQ ID NO: 1940 - protein, 11 aa, Artificial Sequence
  Description of Artificial Sequence: Synthetic polypeptide
DGNVDYHMNSV

SEQ ID NO: 1941 - protein, 16 aa, Artificial Sequence
  Description of Artificial Sequence: Synthetic polypeptide
RSFKEFLQSSLRALRQ

SEQ ID NO: 1942 - protein, 11 aa, Artificial Sequence
  Description of Artificial Sequence: Synthetic polypeptide
FKEFLQSSLRA

SEQ ID NO: 1943 - protein, 10 aa, Artificial Sequence
  Description of Artificial Sequence: Synthetic polypeptide
QMWAPQWGPD

SEQ ID NO: 1944 - protein, 6 aa, Artificial Sequence
  Description of Artificial Sequence: Synthetic polypeptide
RGNRQA

SEQ ID NO: 1945 - protein, 6 aa, Artificial Sequence
  Description of Artificial Sequence: Synthetic polypeptide
SSSTDP

SEQ ID NO: 1946 - protein, 6 aa, Artificial Sequence
  Description of Artificial Sequence: Synthetic polypeptide
SSNTAP

SEQ ID NO: 1947 - protein, 6 aa, Artificial Sequence
  Description of Artificial Sequence: Synthetic polypeptide
SNSNLP

SEQ ID NO: 1948 - protein, 6 aa, Artificial Sequence
  Description of Artificial Sequence: Synthetic polypeptide
SSTTAP

SEQ ID NO: 1949 - protein, 6 aa, Artificial Sequence
  Description of Artificial Sequence: Synthetic polypeptide
AANTAA

SEQ ID NO: 1950 - protein, 6 aa, Artificial Sequence
  Description of Artificial Sequence: Synthetic polypeptide
QQNTAP

SEQ ID NO: 1951 - protein, 6 aa, Artificial Sequence
  Description of Artificial Sequence: Synthetic polypeptide
SAQAQA

SEQ ID NO: 1952 - protein, 6 aa, Artificial Sequence
  Description of Artificial Sequence: Synthetic polypeptide
QANTGP

SEQ ID NO: 1953 - protein, 6 aa, Artificial Sequence
  Description of Artificial Sequence: Synthetic polypeptide
NATTAP

SEQ ID NO: 1954 - protein, 6 aa, Artificial Sequence
  Description of Artificial Sequence: Synthetic polypeptide
SSTAGP

SEQ ID NO: 1955 - protein, 6 aa, Artificial Sequence
  Description of Artificial Sequence: Synthetic polypeptide
QQNTAA

SEQ ID NO: 1956 - protein, 6 aa, Artificial Sequence
  Description of Artificial Sequence: Synthetic polypeptide
PSTAGP

SEQ ID NO: 1957 - protein, 6 aa, Artificial Sequence
  Description of Artificial Sequence: Synthetic polypeptide
NQNTAP

SEQ ID NO: 1958 - protein, 6 aa, Artificial Sequence
  Description of Artificial Sequence: Synthetic polypeptide
QAANAP

SEQ ID NO: 1959 - protein, 6 aa, Artificial Sequence
  Description of Artificial Sequence: Synthetic polypeptide
SIVGLP

SEQ ID NO: 1960 - protein, 6 aa, Artificial Sequence
  Description of Artificial Sequence: Synthetic polypeptide
AASTAA

SEQ ID NO: 1961 - protein, 6 aa, Artificial Sequence
  Description of Artificial Sequence: Synthetic polypeptide
SQNTTA

SEQ ID NO: 1962 - protein, 6 aa, Artificial Sequence
  Description of Artificial Sequence: Synthetic polypeptide
QQDTAP

SEQ ID NO: 1963 - protein, 6 aa, Artificial Sequence
  Description of Artificial Sequence: Synthetic polypeptide
QTNTGP

SEQ ID NO: 1964 - protein, 6 aa, Artificial Sequence
  Description of Artificial Sequence: Synthetic polypeptide
QTNGAP

SEQ ID NO: 1965 - protein, 6 aa, Artificial Sequence
  Description of Artificial Sequence: Synthetic polypeptide
QQNAAP

SEQ ID NO: 1966 - protein, 6 aa, Artificial Sequence
  Description of Artificial Sequence: Synthetic polypeptide
AANTQA

SEQ ID NO: 1967 - protein, 6 aa, Artificial Sequence
  Description of Artificial Sequence: Synthetic polypeptide
NGRAHA

SEQ ID NO: 1968 - protein, 7 aa, Artificial Sequence
  Description of Artificial Sequence: Synthetic polypeptide
QPEHSST

SEQ ID NO: 1969 - protein, 7 aa, Artificial Sequence
  Description of Artificial Sequence: Synthetic polypeptide
VNTANST

SEQ ID NO: 1970 - protein, 7 aa, Artificial Sequence
  Description of Artificial Sequence: Synthetic polypeptide
HGPMQKS

SEQ ID NO: 1971 - protein, 7 aa, Artificial Sequence
  Description of Artificial Sequence: Synthetic polypeptide
PHKPPLA

SEQ ID NO: 1972 - protein, 7 aa, Artificial Sequence
  Description of Artificial Sequence: Synthetic polypeptide
IKNNEMW

SEQ ID NO: 1973 - protein, 7 aa, Artificial Sequence
  Description of Artificial Sequence: Synthetic polypeptide
RNLDTPM

SEQ ID NO: 1974 - protein, 7 aa, Artificial Sequence
  Description of Artificial Sequence: Synthetic polypeptide
VDSHRQS

SEQ ID NO: 1975 - protein, 7 aa, Artificial Sequence
  Description of Artificial Sequence: Synthetic polypeptide
YDSKTKT

SEQ ID NO: 1976 - protein, 7 aa, Artificial Sequence
  Description of Artificial Sequence: Synthetic polypeptide
SQLPHQK

SEQ ID NO: 1977 - protein, 7 aa, Artificial Sequence
  Description of Artificial Sequence: Synthetic polypeptide
STMQQNT

SEQ ID NO: 1978 - protein, 7 aa, Artificial Sequence
  Description of Artificial Sequence: Synthetic polypeptide
TERYMTQ

SEQ ID NO: 1979 - protein, 7 aa, Artificial Sequence
  Description of Artificial Sequence: Synthetic polypeptide
DASLSTS

SEQ ID NO: 1980 - protein, 7 aa, Artificial Sequence
  Description of Artificial Sequence: Synthetic polypeptide
DLPNKKT

SEQ ID NO: 1981 - protein, 7 aa, Artificial Sequence
  Description of Artificial Sequence: Synthetic polypeptide
DLTAARL

SEQ ID NO: 1982 - protein, 7 aa, Artificial Sequence
  Description of Artificial Sequence: Synthetic polypeptide
EPHQFNY

SEQ ID NO: 1983 - protein, 7 aa, Artificial Sequence
  Description of Artificial Sequence: Synthetic polypeptide
EPQSNHT

SEQ ID NO: 1984 - protein, 7 aa, Artificial Sequence
  Description of Artificial Sequence: Synthetic polypeptide
MSSWPSQ

SEQ ID NO: 1985 - protein, 7 aa, Artificial Sequence
  Description of Artificial Sequence: Synthetic polypeptide
NPKHNAT

SEQ ID NO: 1986 - protein, 7 aa, Artificial Sequence
  Description of Artificial Sequence: Synthetic polypeptide
PDGMRTT

SEQ ID NO: 1987 - protein, 7 aa, Artificial Sequence
  Description of Artificial Sequence: Synthetic polypeptide
PNNNKTT

SEQ ID NO: 1988 - protein, 7 aa, Artificial Sequence
  Description of Artificial Sequence: Synthetic polypeptide
QSTTHDS

SEQ ID NO: 1989 - protein, 7 aa, Artificial Sequence
  Description of Artificial Sequence: Synthetic polypeptide
TGSKQKQ

SEQ ID NO: 1990 - protein, 7 aa, Artificial Sequence
  Description of Artificial Sequence: Synthetic polypeptide
SLKHQAL

SEQ ID NO: 1991 - protein, 7 aa, Artificial Sequence
  Description of Artificial Sequence: Synthetic polypeptide
SPIDGEQ

SEQ ID NO: 1992 - protein, 8 aa, Artificial Sequence
  Description of Artificial Sequence: Synthetic polypeptide
WIFPWIQL

SEQ ID NO: 1993 - protein, 9 aa, Artificial Sequence
  Description of Artificial Sequence: Synthetic polypeptide
CDCRGDCFC

SEQ ID NO: 1994 - protein, 5 aa, Artificial Sequence
  Description of Artificial Sequence: Synthetic polypeptide
CNGRC

SEQ ID NO: 1995 - protein, 7 aa, Artificial Sequence
  Description of Artificial Sequence: Synthetic polypeptide
CPRECES

SEQ ID NO: 1996 - protein, 10 aa, Artificial Sequence
  Description of Artificial Sequence: Synthetic polypeptide
CTTHWGFTLC

SEQ ID NO: 1997 - protein, 9 aa, Artificial Sequence
  Description of Artificial Sequence: Synthetic polypeptide
CGRRAGGSC

SEQ ID NO: 1998 - protein, 9 aa, Artificial Sequence
  Description of Artificial Sequence: Synthetic polypeptide
CKGGRAKDC

SEQ ID NO: 1999 - protein, 9 aa, Artificial Sequence
  Description of Artificial Sequence: Synthetic polypeptide
CVPELGHEC

SEQ ID NO: 2000 - protein, 9 aa, Artificial Sequence
  Description of Artificial Sequence: Synthetic polypeptide
CRRETAWAK

SEQ ID NO: 2001 - protein, 14 aa, Artificial Sequence
  Description of Artificial Sequence: Synthetic polypeptide
VSWFSHRYSPFAVS

SEQ ID NO: 2002 - protein, 13 aa, Artificial Sequence
  Description of Artificial Sequence: Synthetic polypeptide
GYRDGYAGPILYN

SEQ ID NO: 2003 - protein, 7 aa, Artificial Sequence
  Description of Artificial Sequence: Synthetic polypeptide
  MOD_RES (1)..(3): Xaa can be any naturally occurring amino acid
  MOD_RES (5)..(7): Xaa can be any naturally occurring amino acid
XXXYXXX

SEQ ID NO: 2004 - protein, 4 aa, Artificial Sequence
  Description of Artificial Sequence: Synthetic polypeptide
  MOD_RES (2)..(2): Xaa is Gly or Leu
YXNW

SEQ ID NO: 2005 - protein, 7 aa, Artificial Sequence
  Description of Artificial Sequence: Synthetic polypeptide
RPLPPLP

SEQ ID NO: 2006 - protein, 7 aa, Artificial Sequence
  Description of Artificial Sequence: Synthetic polypeptide
APPLPPR

SEQ ID NO: 2007 - protein, 12 aa, Artificial Sequence
  Description of Artificial Sequence: Synthetic polypeptide
DVFYPYPYASGS

SEQ ID NO: 2008 - protein, 6 aa, Artificial Sequence
  Description of Artificial Sequence: Synthetic polypeptide
MYWYPY

SEQ ID NO: 2009 - protein, 12 aa, Artificial Sequence
  Description of Artificial Sequence: Synthetic polypeptide
DITWDQLWDLMK

SEQ ID NO: 2010 - protein, 8 aa, Artificial Sequence
  Description of Artificial Sequence: Synthetic polypeptide
  MOD_RES (5)..(5): Xaa is Gly or Leu
CWDDXWLC

SEQ ID NO: 2011 - protein, 14 aa, Artificial Sequence
  Description of Artificial Sequence: Synthetic polypeptide
EWCEYLGGYLRCYA

SEQ ID NO: 2012 - protein, 14 aa, Artificial Sequence
  Description of Artificial Sequence: Synthetic polypeptide
  MOD_RES (2)..(2): Xaa can be any naturally occurring amino acid
  MOD_RES (4)..(5): Xaa can be any naturally occurring amino acid
  MOD_RES (8)..(8): Xaa can be any naturally occurring amino acid
  MOD_RES (11)..(11): Xaa can be any naturally occurring amino acid
  MOD_RES (13)..(13): Xaa can be any naturally occurring amino acid
YXCXXGPXTWXCXP

SEQ ID NO: 2013 - protein, 14 aa, Artificial Sequence
  Description of Artificial Sequence: Synthetic polypeptide
IEGPTLRQWLAARA

SEQ ID NO: 2014 - protein, 5 aa, Artificial Sequence
  Description of Artificial Sequence: Synthetic polypeptide
  MOD_RES (3)..(5): Xaa can be any naturally occurring amino acid
LWXXX

SEQ ID NO: 2015 - protein, 7 aa, Artificial Sequence
  Description of Artificial Sequence: Synthetic polypeptide
  MOD_RES (1)..(1): Xaa can be any naturally occurring amino acid
  MOD_RES (3)..(4): Xaa can be any naturally occurring amino acid
XFXXYLW

SEQ ID NO: 2016 - protein, 13 aa, Artificial Sequence
  Description of Artificial Sequence: Synthetic polypeptide
SSIISHFRWGLCD

SEQ ID NO: 2017 - protein, 13 aa, Artificial Sequence
  Description of Artificial Sequence: Synthetic polypeptide
MSRPACPPNDKYE

SEQ ID NO: 2018 - protein, 8 aa, Artificial Sequence
  Description of Artificial Sequence: Synthetic polypeptide
CLRSGRGC

SEQ ID NO: 2019 - protein, 9 aa, Artificial Sequence
  Description of Artificial Sequence: Synthetic polypeptide
CHWMFSPWC

SEQ ID NO: 2020 - protein, 4 aa, Artificial Sequence
  Description of Artificial Sequence: Synthetic polypeptide
  MOD_RES (2)..(3): Xaa can be any naturally occurring amino acid
WXXF

SEQ ID NO: 2021 - protein, 8 aa, Artificial Sequence
  Description of Artificial Sequence: Synthetic polypeptide
CSSRLDAC

SEQ ID NO: 2022 - protein, 7 aa, Artificial Sequence
  Description of Artificial Sequence: Synthetic polypeptide
CLPVASC

SEQ ID NO: 2023 - protein, 13 aa, Artificial Sequence
  Description of Artificial Sequence: Synthetic polypeptide
CGFECVRQCPERC

SEQ ID NO: 2024 - protein, 13 aa, Artificial Sequence
  Description of Artificial Sequence: Synthetic polypeptide
CVALCREACGEGC

SEQ ID NO: 2025 - protein, 9 aa, Artificial Sequence
  Description of Artificial Sequence: Synthetic polypeptide
SWCEPGWCR

SEQ ID NO: 2026 - protein, 7 aa, Artificial Sequence
  Description of Artificial Sequence: Synthetic polypeptide
YSGKWGW

SEQ ID NO: 2027 - protein, 7 aa, Artificial Sequence
  Description of Artificial Sequence: Synthetic polypeptide
GLSGGRS

SEQ ID NO: 2028 - protein, 7 aa, Artificial Sequence
  Description of Artificial Sequence: Synthetic polypeptide
LMLPRAD

SEQ ID NO: 2029 - protein, 9 aa, Artificial Sequence
  Description of Artificial Sequence: Synthetic polypeptide
CSCFRDVCC

SEQ ID NO: 2030 - protein, 9 aa, Artificial Sequence
  Description of Artificial Sequence: Synthetic polypeptide
CRDVVSVIC

SEQ ID NO: 2031 - protein, 6 aa, Artificial Sequence
  Description of Artificial Sequence: Synthetic polypeptide
MARSGL

SEQ ID NO: 2032 - protein, 6 aa, Artificial Sequence
  Description of Artificial Sequence: Synthetic polypeptide
MARAKE

SEQ ID NO: 2033 - protein, 6 aa, Artificial Sequence
  Description of Artificial Sequence: Synthetic polypeptide
MSRTMS

SEQ ID NO: 2034 - protein, 6 aa, Artificial Sequence
  Description of Artificial Sequence: Synthetic polypeptide
KCCYSL

SEQ ID NO: 2035 - protein, 14 aa, Artificial Sequence
  Description of Artificial Sequence: Synthetic polypeptide
MYWGDSHWLQYWYE

SEQ ID NO: 2036 - protein, 7 aa, Artificial Sequence
  Description of Artificial Sequence: Synthetic polypeptide
MQLPLAT

SEQ ID NO: 2037 - protein, 4 aa, Artificial Sequence
  Description of Artificial Sequence: Synthetic polypeptide
EWLS

SEQ ID NO: 2038 - protein, 4 aa, Artificial Sequence
  Description of Artificial Sequence: Synthetic polypeptide
SNEW

SEQ ID NO: 2039 - protein, 4 aa, Artificial Sequence
  Description of Artificial Sequence: Synthetic polypeptide
TNYL

SEQ ID NO: 2040 - protein, 12 aa, Artificial Sequence
  Description of Artificial Sequence: Synthetic polypeptide
WDLAWMFRLPVG

SEQ ID NO: 2041 - protein, 13 aa, Artificial Sequence
  Description of Artificial Sequence: Synthetic polypeptide
CTVALPGGYVRVC

SEQ ID NO: 2042 - protein, 13 aa, Artificial Sequence
  Description of Artificial Sequence: Synthetic polypeptide
CVAYCIEHHCWTC

SEQ ID NO: 2043 - protein, 12 aa, Artificial Sequence
  Description of Artificial Sequence: Synthetic polypeptide
CVFAHNYDYLVC

SEQ ID NO: 2044 - protein, 10 aa, Artificial Sequence
  Description of Artificial Sequence: Synthetic polypeptide
CVFTSNYAFC

SEQ ID NO: 2045 - protein, 7 aa, Artificial Sequence
  Description of Artificial Sequence: Synthetic polypeptide
VHSPNKK

SEQ ID NO: 2046 - protein, 7 aa, Artificial Sequence
  Description of Artificial Sequence: Synthetic polypeptide
CRGDGWC

SEQ ID NO: 2047 - protein, 6 aa, Artificial Sequence
  Description of Artificial Sequence: Synthetic polypeptide
  MOD_RES (1)..(1): Xaa can be any naturally occurring amino acid
  MOD_RES (6)..(6): Xaa can be any naturally occurring amino acid
XRGCDX

SEQ ID NO: 2048 - protein, 4 aa, Artificial Sequence
  Description of Artificial Sequence: Synthetic polypeptide
  MOD_RES (2)..(4): Xaa can be any naturally occurring amino acid
PXXX

SEQ ID NO: 2049 - protein, 11 aa, Artificial Sequence
  Description of Artificial Sequence: Synthetic polypeptide
SGKGPRQITAL

SEQ ID NO: 2050 - protein, 14 aa, Artificial Sequence
  Description of Artificial Sequence: Synthetic polypeptide
  MOD_RES (10)..(10): Xaa is Ala or Gln
  MOD_RES (11)..(11): Xaa is Asn or Ala
  MOD_RES (12)..(14): Xaa can be any naturally occurring amino acid
AAAAAAAAAXXXXX

SEQ ID NO: 2051 - protein, 6 aa, Artificial Sequence
  Description of Artificial Sequence: Synthetic polypeptide
VYMSPF

SEQ ID NO: 2052 - protein, 7 aa, Artificial Sequence
  Description of Artificial Sequence: Synthetic polypeptide
ATWLPPR

SEQ ID NO: 2053 - protein, 12 aa, Artificial Sequence
  Description of Artificial Sequence: Synthetic polypeptide
HTMYYHHYQHHL

SEQ ID NO: 2054 - protein, 19 aa, Artificial Sequence
  Description of Artificial Sequence: Synthetic polypeptide
SEVGCRAGPLQWLCEKYFG

SEQ ID NO: 2055 - protein, 18 aa, Artificial Sequence
  Description of Artificial Sequence: Synthetic polypeptide
CGLLPVGRPDRNVWRWLC

SEQ ID NO: 2056 - protein, 15 aa, Artificial Sequence
  Description of Artificial Sequence: Synthetic polypeptide
CKGQCDRFKGLPWEC

SEQ ID NO: 2057 - protein, 5 aa, Artificial Sequence
  Description of Artificial Sequence: Synthetic polypeptide
SGRSA

SEQ ID NO: 2058 - protein, 4 aa, Artificial Sequence
  Description of Artificial Sequence: Synthetic polypeptide
WGFP

SEQ ID NO: 2059 - protein, 17 aa, Artificial Sequence
  Description of Artificial Sequence: Synthetic polypeptide
AEPMPHSLNFSQYLWYT

SEQ ID NO: 2060 - protein, 6 aa, Artificial Sequence
  Description of Artificial Sequence: Synthetic polypeptide
  MOD_RES (4)..(4): Xaa is Trp or Phe
WAYXSP

SEQ ID NO: 2061 - protein, 7 aa, Artificial Sequence
  Description of Artificial Sequence: Synthetic polypeptide
IELLQAR

SEQ ID NO: 2062 - protein, 16 aa, Artificial Sequence
  Description of Artificial Sequence: Synthetic polypeptide
AYTKCSRQWRTCMTTH

SEQ ID NO: 2063 - protein, 15 aa, Artificial Sequence
  Description of Artificial Sequence: Synthetic polypeptide
PQNSKIPGPTFLDPH

SEQ ID NO: 2064 - protein, 15 aa, Artificial Sequence
  Description of Artificial Sequence: Synthetic polypeptide
SMEPALPDWWWKMFK

SEQ ID NO: 2065 - protein, 16 aa, Artificial Sequence
  Description of Artificial Sequence: Synthetic polypeptide
ANTPCGPYTHDCPVKR

SEQ ID NO: 2066 - protein, 12 aa, Artificial Sequence
  Description of Artificial Sequence: Synthetic polypeptide
TACHQHVRMVRP

SEQ ID NO: 2067 - protein, 12 aa, Artificial Sequence
  Description of Artificial Sequence: Synthetic polypeptide
VPWMEPAYQRFL

SEQ ID NO: 2068 - protein, 8 aa, Artificial Sequence
  Description of Artificial Sequence: Synthetic polypeptide
DPRATPGS

SEQ ID NO: 2069 - protein, 12 aa, Artificial Sequence
  Description of Artificial Sequence: Synthetic polypeptide
FRPNRAQDYNTN

SEQ ID NO: 2070 - protein, 9 aa, Artificial Sequence
  Description of Artificial Sequence: Synthetic polypeptide
CTKNSYLMC

SEQ ID NO: 2071 - protein, 11 aa, Artificial Sequence
  Description of Artificial Sequence: Synthetic polypeptide
  MOD_RES (2)..(2): Xaa is Gln or Arg
  MOD_RES (3)..(3): Xaa is Leu or Arg
  MOD_RES (5)..(5): Xaa is Gly or Asn
  MOD_RES (6)..(7): Xaa is any amino acid residue
  MOD_RES (9)..(9): Xaa is Ala or Val
CXXTXXXGXGC

SEQ ID NO: 2072 - protein, 9 aa, Artificial Sequence
  Description of Artificial Sequence: Synthetic polypeptide
CPIEDRPMC

SEQ ID NO: 2073 - protein, 12 aa, Artificial Sequence
  Description of Artificial Sequence: Synthetic polypeptide
HEWSYLAPYPWF

SEQ ID NO: 2074 - protein, 9 aa, Artificial Sequence
  Description of Artificial Sequence: Synthetic polypeptide
MCPKHPLGC

SEQ ID NO: 2075 - protein, 15 aa, Artificial Sequence
  Description of Artificial Sequence: Synthetic polypeptide
RMWPSSTVNLSAGRR

SEQ ID NO: 2076 - protein, 20 aa, Artificial Sequence
  Description of Artificial Sequence: Synthetic polypeptide
SAKTAVSQRVWLPSHRGGEP

SEQ ID NO: 2077 - protein, 20 aa, Artificial Sequence
  Description of Artificial Sequence: Synthetic polypeptide
KSREHVNNSACPSKRITAAL

SEQ ID NO: 2078 - protein, 4 aa, Artificial Sequence
  Description of Artificial Sequence: Synthetic polypeptide
EGFR

SEQ ID NO: 2079 - protein, 6 aa, Artificial Sequence
  Description of Artificial Sequence: Synthetic polypeptide
AGLGVR

SEQ ID NO: 2080 - protein, 15 aa, Artificial Sequence
  Description of Artificial Sequence: Synthetic polypeptide
GTRQGHTMRLGVSDG

SEQ ID NO: 2081 - protein, 15 aa, Artificial Sequence
  Description of Artificial Sequence: Synthetic polypeptide
IAGLATPGWSHWLAL

SEQ ID NO: 2082 - protein, 7 aa, Artificial Sequence
  Description of Artificial Sequence: Synthetic polypeptide
SMSIARL

SEQ ID NO: 2083 - protein, 7 aa, Artificial Sequence
  Description of Artificial Sequence: Synthetic polypeptide
HTFEPGV

SEQ ID NO: 2084 - protein, 15 aa, Artificial Sequence
  Description of Artificial Sequence: Synthetic polypeptide
NTSLKRISNKRIRRK

SEQ ID NO: 2085 - protein, 15 aa, Artificial Sequence
  Description of Artificial Sequence: Synthetic polypeptide
LRIKRKRRKRKKTRK

SEQ ID NO: 2086 - DNA, 21 bp, adeno-associated virus 2
  misc_feature (3)..(3): a, c, t, or g
agnvvmdcaggarscascaac

SEQ ID NO: 2087 - protein, 7 aa, Artificial Sequence
  Description of Artificial Sequence: Synthetic polypeptide
SDSGASN

SEQ ID NO: 2088 - protein, 7 aa, Artificial Sequence
  Description of Artificial Sequence: Synthetic polypeptide
SPSGASN

SEQ ID NO: 2089 - protein, 7 aa, Artificial Sequence
  Description of Artificial Sequence: Synthetic polypeptide
SHSGASN

SEQ ID NO: 2090 - protein, 7 aa, Artificial Sequence
  Description of Artificial Sequence: Synthetic polypeptide
SRSGASN

SEQ ID NO: 2091 - protein, 7 aa, Artificial Sequence
  Description of Artificial Sequence: Synthetic polypeptide
SKSGASN

SEQ ID NO: 2092 - protein, 7 aa, Artificial Sequence
  Description of Artificial Sequence: Synthetic polypeptide
SNSGASN

SEQ ID NO: 2093 - protein, 7 aa, Artificial Sequence
  Description of Artificial Sequence: Synthetic polypeptide
SGSGASN

SEQ ID NO: 2094 - protein, 7 aa, Artificial Sequence
  Description of Artificial Sequence: Synthetic polypeptide
SASGASN

SEQ ID NO: 2095 - protein, 7 aa, Artificial Sequence
  Description of Artificial Sequence: Synthetic polypeptide
SESGTSN

SEQ ID NO: 2096 - protein, 7 aa, Artificial Sequence
  Description of Artificial Sequence: Synthetic polypeptide
STTGGSN

SEQ ID NO: 2097 - protein, 7 aa, Artificial Sequence
  Description of Artificial Sequence: Synthetic polypeptide
SSAGSTN

SEQ ID NO: 2098 - protein, 6 aa, Artificial Sequence
  Description of Artificial Sequence: Synthetic polypeptide
NNDSQA

SEQ ID NO: 2099 - protein, 6 aa, Artificial Sequence
  Description of Artificial Sequence: Synthetic polypeptide
NNRNQA

SEQ ID NO: 2100 - protein, 6 aa, Artificial Sequence
  Description of Artificial Sequence: Synthetic polypeptide
NNNKQA

SEQ ID NO: 2101 - protein, 6 aa, Artificial Sequence
  Description of Artificial Sequence: Synthetic polypeptide
NAKRQA

SEQ ID NO: 2102 - protein, 6 aa, Artificial Sequence
  Description of Artificial Sequence: Synthetic polypeptide
NDEHQA

SEQ ID NO: 2103 - protein, 6 aa, Artificial Sequence
  Description of Artificial Sequence: Synthetic polypeptide
NTSQKA

SEQ ID NO: 2104 - protein, 25 aa, Artificial Sequence
  Description of Artificial Sequence: Synthetic polypeptide
YYLSRTNTPSGTDTQSRLVFSQAGA

SEQ ID NO: 2105 - protein, 25 aa, Artificial Sequence
  Description of Artificial Sequence: Synthetic polypeptide
YYLSRTNTDSGTETQSGLDFSQAGA

SEQ ID NO: 2106 - protein, 25 aa, Artificial Sequence
  Description of Artificial Sequence: Synthetic polypeptide
YYLSRTNTESGTPTQSALEFSQAGA

SEQ ID NO: 2107 - protein, 25 aa, Artificial Sequence
  Description of Artificial Sequence: Synthetic polypeptide
YYLSRTNTHSGTHTQSPLHFSQAGA

SEQ ID NO: 2108 - protein, 25 aa, Artificial Sequence
  Description of Artificial Sequence: Synthetic polypeptide
YYLSRTNTSSGTITISHLIFSQAGA

SEQ ID NO: 2109 - protein, 25 aa, Artificial Sequence
  Description of Artificial Sequence: Synthetic polypeptide
YYLSRTNTRSGIMTKSSLMFSQAGA

SEQ ID NO: 2110 - protein, 25 aa, Artificial Sequence
  Description of Artificial Sequence: Synthetic polypeptide
YYLSRTNTKSGRKTLSNLSFSQAGA

SEQ ID NO: 2111 - protein, 25 aa, Artificial Sequence
  Description of Artificial Sequence: Synthetic polypeptide
YYLSRTNDGSGPVTPSKLRFSQRGA

SEQ ID NO: 2112 - protein, 25 aa, Artificial Sequence
  Description of Artificial Sequence: Synthetic polypeptide
YYLSRTNAASGHATHSDLKFSQPGA

SEQ ID NO: 2113 - protein, 25 aa, Artificial Sequence
  Description of Artificial Sequence: Synthetic polypeptide
YYLSRTNGQAGSLTMSELGFSQVGA

SEQ ID NO: 2114 - protein, 25 aa, Artificial Sequence
  Description of Artificial Sequence: Synthetic polypeptide
YYLSRTNSTGGNQTTSQLLFSQLSA

SEQ ID NO: 2115 - protein, 25 aa, Artificial Sequence
  Description of Artificial Sequence: Synthetic polypeptide
YFLSRTNNNTGLNTNSTLNFSQGRA

SEQ ID NO: 2116 - protein, 16 aa, Artificial Sequence
  Description of Artificial Sequence: Synthetic polypeptide
SKTGADNNNSEYSWTG

SEQ ID NO: 2117 - protein, 16 aa, Artificial Sequence
  Description of Artificial Sequence: Synthetic polypeptide
SKTDADNNNSEYSWTG

SEQ ID NO: 2118 - protein, 16 aa, Artificial Sequence
  Description of Artificial Sequence: Synthetic polypeptide
SKTEADNNNSEYSWTG

SEQ ID NO: 2119 - protein, 16 aa, Artificial Sequence
  Description of Artificial Sequence: Synthetic polypeptide
SKTPADNNNSEYSWTG

SEQ ID NO: 2120 - protein, 16 aa, Artificial Sequence
  Description of Artificial Sequence: Synthetic polypeptide
SKTHADNNNSEYSWTG

SEQ ID NO: 2121 - protein, 16 aa, Artificial Sequence
  Description of Artificial Sequence: Synthetic polypeptide
SKTQADNNNSEYSWTG

SEQ ID NO: 2122 - protein, 16 aa, Artificial Sequence
  Description of Artificial Sequence: Synthetic polypeptide
SKTIADNNNSEYSWTG

SEQ ID NO: 2123 - protein, 16 aa, Artificial Sequence
  Description of Artificial Sequence: Synthetic polypeptide
SKTMADNNNSEYSWTG

SEQ ID NO: 2124 - protein, 16 aa, Artificial Sequence
  Description of Artificial Sequence: Synthetic polypeptide
SKTRADNNNSEYSWTG

SEQ ID NO: 2125 - protein, 16 aa, Artificial Sequence
  Description of Artificial Sequence: Synthetic polypeptide
SKTNADNNNSEYSWTG

SEQ ID NO: 2126 - protein, 16 aa, Artificial Sequence
  Description of Artificial Sequence: Synthetic polypeptide
SKTVGRNNNSEYSWTG

SEQ ID NO: 2127 - protein, 16 aa, Artificial Sequence
  Description of Artificial Sequence: Synthetic polypeptide
SKTADRNNNSEYSWTG

SEQ ID NO: 2128 - protein, 16 aa, Artificial Sequence
  Description of Artificial Sequence: Synthetic polypeptide
SKKLSQNNNSKYSWQG

SEQ ID NO: 2129 - protein, 16 aa, Artificial Sequence
  Description of Artificial Sequence: Synthetic polypeptide
SKPTTGNNNSDYSWPG

SEQ ID NO: 2130 - protein, 16 aa, Artificial Sequence
  Description of Artificial Sequence: Synthetic polypeptide
STQKNENNNSNYSWPG

SEQ ID NO: 2131 - protein, 8 aa, Artificial Sequence
  Description of Artificial Sequence: Synthetic polypeptide
HKDDEGKF

SEQ ID NO: 2132 - protein, 8 aa, Artificial Sequence
  Description of Artificial Sequence: Synthetic polypeptide
HKDDNRKF

SEQ ID NO: 2133 - protein, 8 aa, Artificial Sequence
  Description of Artificial Sequence: Synthetic polypeptide
HKDDTNKF

SEQ ID NO: 2134 - protein, 8 aa, Artificial Sequence
  Description of Artificial Sequence: Synthetic polypeptide
HEDSDKNF

SEQ ID NO: 2135 - protein, 8 aa, Artificial Sequence
  Description of Artificial Sequence: Synthetic polypeptide
HRDGADSF

SEQ ID NO: 2136 - protein, 8 aa, Artificial Sequence
  Description of Artificial Sequence: Synthetic polypeptide
HGDNKSRF

SEQ ID NO: 2137 - protein, 14 aa, Artificial Sequence
  Description of Artificial Sequence: Synthetic polypeptide
KQGSEKTNVDFEEV

SEQ ID NO: 2138 - protein, 14 aa, Artificial Sequence
  Description of Artificial Sequence: Synthetic polypeptide
KQGSEKTNVDSEEV

SEQ ID NO: 2139 - protein, 14 aa, Artificial Sequence
  Description of Artificial Sequence: Synthetic polypeptide
KQGSEKTNVDVEEV

SEQ ID NO: 2140 - protein, 14 aa, Artificial Sequence
  Description of Artificial Sequence: Synthetic polypeptide
KQGSDKTNVDDAGV

SEQ ID NO: 2141 - protein, 14 aa, Artificial Sequence
  Description of Artificial Sequence: Synthetic polypeptide
KQGSSKTNVDPREV

SEQ ID NO: 2142 - protein, 14 aa, Artificial Sequence
  Description of Artificial Sequence: Synthetic polypeptide
KQGSRKTNVDHKQV

SEQ ID NO: 2143 - protein, 14 aa, Artificial Sequence
  Description of Artificial Sequence: Synthetic polypeptide
KQGSKGGNVDTNRV

SEQ ID NO: 2144 - protein, 14 aa, Artificial Sequence
  Description of Artificial Sequence: Synthetic polypeptide
KQGSGEANVDNGDV

SEQ ID NO: 2145 - protein, 14 aa, Artificial Sequence
  Description of Artificial Sequence: Synthetic polypeptide
KQDAAADNIDYDHV

SEQ ID NO: 2146 - protein, 14 aa, Artificial Sequence
  Description of Artificial Sequence: Synthetic polypeptide
KQSGTRSNAAASSV

SEQ ID NO: 2147 - protein, 14 aa, Artificial Sequence
  Description of Artificial Sequence: Synthetic polypeptide
KENTNTNDTELTNV

SEQ ID NO: 2148 - protein, 14 aa, Artificial Sequence
  Description of Artificial Sequence: Synthetic polypeptide
QRGNNVAATADVNT

SEQ ID NO: 2149 - protein, 14 aa, Artificial Sequence
  Description of Artificial Sequence: Synthetic polypeptide
QRGNNEAATADVNT

SEQ ID NO: 2150 - protein, 14 aa, Artificial Sequence
  Description of Artificial Sequence: Synthetic polypeptide
QRGNNPAATADVNT

SEQ ID NO: 2151 - protein, 14 aa, Artificial Sequence
  Description of Artificial Sequence: Synthetic polypeptide
QRGNNHAATADVNT

SEQ ID NO: 2152 - protein, 14 aa, Artificial Sequence
  Description of Artificial Sequence: Synthetic polypeptide
QEENNIAATPGVNT

SEQ ID NO: 2153 - protein, 14 aa, Artificial Sequence
  Description of Artificial Sequence: Synthetic polypeptide
QPPNNMAATHEVNT

SEQ ID NO: 2154 - protein, 14 aa, Artificial Sequence
  Description of Artificial Sequence: Synthetic polypeptide
QHHNNSAATTIVNT

SEQ ID NO: 2155 - protein, 14 aa, Artificial Sequence
  Description of Artificial Sequence: Synthetic polypeptide
QTTNNRAAFNMVET

SEQ ID NO: 2156 - protein, 14 aa, Artificial Sequence
  Description of Artificial Sequence: Synthetic polypeptide
QKKNNNAASKKVAT

SEQ ID NO: 2157 - protein, 14 aa, Artificial Sequence
  Description of Artificial Sequence: Synthetic polypeptide
QGGNNKAADDAVKT

SEQ ID NO: 2158 - protein, 14 aa, Artificial Sequence
  Description of Artificial Sequence: Synthetic polypeptide
QAAKGGAADDAVKT

SEQ ID NO: 2159 - protein, 14 aa, Artificial Sequence
  Description of Artificial Sequence: Synthetic polypeptide
QDDRAAAANESVDT

SEQ ID NO: 2160 - protein, 14 aa, Artificial Sequence
  Description of Artificial Sequence: Synthetic polypeptide
QQQHDDAAYQRVHT

SEQ ID NO: 2161 - protein, 14 aa, Artificial Sequence
  Description of Artificial Sequence: Synthetic polypeptide
QSSSSLAAVSTVQT

SEQ ID NO: 2162 - protein, 14 aa, Artificial Sequence
  Description of Artificial Sequence: Synthetic polypeptide
QNNQTTAAIRNVTT

SEQ ID NO: 2163 - protein, 12 aa, Artificial Sequence
  Description of Artificial Sequence: Synthetic polypeptide
NYNKKSDNVDFT

SEQ ID NO: 2164 - protein, 12 aa, Artificial Sequence
  Description of Artificial Sequence: Synthetic polypeptide
NYNKKSENVDFT

SEQ ID NO: 2165 - protein, 12 aa, Artificial Sequence
  Description of Artificial Sequence: Synthetic polypeptide
NYNKKSLNVDFT

SEQ ID NO: 2166 - protein, 12 aa, Artificial Sequence
  Description of Artificial Sequence: Synthetic polypeptide
NYNKKSPNVDFT

SEQ ID NO: 2167 - protein, 12 aa, Artificial Sequence
  Description of Artificial Sequence: Synthetic polypeptide
NYSKKSHCVDFT

SEQ ID NO: 2168 - protein, 11 aa, Artificial Sequence
  Description of Artificial Sequence: Synthetic polypeptide
NYRKTIYVDFT

SEQ ID NO: 2169 - protein, 11 aa, Artificial Sequence
  Description of Artificial Sequence: Synthetic polypeptide
NYKEKKDVHFT

SEQ ID NO: 2170 - protein, 11 aa, Artificial Sequence
  Description of Artificial Sequence: Synthetic polypeptide
NYGHRAIVQFT

SEQ ID NO: 2171 - protein, 11 aa, Artificial Sequence
  Description of Artificial Sequence: Synthetic polypeptide
NYANHQFVVCT

SEQ ID NO: 2172 - protein, 12 aa, Artificial Sequence
  Description of Artificial Sequence: Synthetic polypeptide
NYDDDPTGVLLT

SEQ ID NO: 2173 - protein, 11 aa, Artificial Sequence
  Description of Artificial Sequence: Synthetic polypeptide
NYDDPTGVLLT

SEQ ID NO: 2174 - protein, 11 aa, Artificial Sequence
  Description of Artificial Sequence: Synthetic polypeptide
NFEQQNSVEWT

SEQ ID NO: 2175 - protein, 7 aa, Artificial Sequence
  Description of Artificial Sequence: Synthetic polypeptide
SQSGASN

SEQ ID NO: 2176 - protein, 6 aa, Artificial Sequence
  Description of Artificial Sequence: Synthetic polypeptide
NNGSQA

SEQ ID NO: 2177 - protein, 25 aa, Artificial Sequence
  Description of Artificial Sequence: Synthetic polypeptide
YYLSRTNTPSGTTTWSRLQFSQAGA

SEQ ID NO: 2178 - protein, 16 aa, Artificial Sequence
  Description of Artificial Sequence: Synthetic polypeptide
SKTSADNNNSEYSWTG

SEQ ID NO: 2179 - protein, 8 aa, Artificial Sequence
  Description of Artificial Sequence: Synthetic polypeptide
HKDDEEKF

SEQ ID NO: 2180 - protein, 14 aa, Artificial Sequence
  Description of Artificial Sequence: Synthetic polypeptide
KQGSEKTNVDIEEV

SEQ ID NO: 2181 - protein, 14 aa, Artificial Sequence
  Description of Artificial Sequence: Synthetic polypeptide
QRGNNQAATADVNT

SEQ ID NO: 2182 - protein, 12 aa, Artificial Sequence
  Description of Artificial Sequence: Synthetic polypeptide
NYNKKSVNVDFT

SEQ ID NO: 2183 - protein, 42 aa, Artificial Sequence
  Description of Artificial Sequence: Synthetic polypeptide
SQSGASNYNTPSGTTTQSRLQFSTSADNNNSEYSWTGATKYH

SEQ ID NO: 2184 - protein, 42 aa, Artificial Sequence
  Description of Artificial Sequence: Synthetic polypeptide
SASGASNFNSEGGSLTQSSLGFSTDGENNNSDFSWTGATKYH

SEQ ID NO: 2185 - protein, 42 aa, Artificial Sequence
  Description of Artificial Sequence: Synthetic polypeptide
SQSGASNYNTPSGTTTQSRLQFSTDGENNNSDFSWTGATKYH

SEQ ID NO: 2186 - protein, 42 aa, Artificial Sequence
  Description of Artificial Sequence: Synthetic polypeptide
SASGASNYNTPSGTTTQSRLQFSTSADNNNSEFSWPGATTYH

SEQ ID NO: 2187 - protein, 42 aa, Artificial Sequence
  Description of Artificial Sequence: Synthetic polypeptide
SQSGASNFNSEGGSLTQSSLGFSTDGENNNSDFSWTGATKYH

SEQ ID NO: 2188 - protein, 42 aa, Artificial Sequence
  Description of Artificial Sequence: Synthetic polypeptide
SASGASNYNTPSGSLTQSSLGFSTDGENNNSDFSWTGATKYH

SEQ ID NO: 2189 - protein, 42 aa, Artificial Sequence
  Description of Artificial Sequence: Synthetic polypeptide
SQSGASNYNTPSGTTTQSRLQFSTSADNNNSDFSWTGATKYH

SEQ ID NO: 2190 - protein, 42 aa, Artificial Sequence
  Description of Artificial Sequence: Synthetic polypeptide
SGAGASNFNSEGGSLTQSSLGFSTDGENNNSDFSWTGATKYH

SEQ ID NO: 2191 - protein, 7 aa, Artificial Sequence
  Description of Artificial Sequence: Synthetic polypeptide
SGAGASN

SEQ ID NO: 2192 - protein, 15 aa, Artificial Sequence
  Description of Artificial Sequence: Synthetic polypeptide
NSEGGSLTQSSLGFS

SEQ ID NO: 2193 - protein, 11 aa, Artificial Sequence
  Description of Artificial Sequence: Synthetic polypeptide
TDGENNNSDFS

SEQ ID NO: 2194 - protein, 10 aa, Artificial Sequence
  Description of Artificial Sequence: Synthetic polypeptide
SEFSWPGATT

SEQ ID NO: 2195 - protein, 13 aa, Artificial Sequence
  Description of Artificial Sequence: Synthetic polypeptide
TSADNNNSDFSWT

SEQ ID NO: 2196 - protein, 8 aa, Artificial Sequence
  Description of Artificial Sequence: Synthetic polypeptide
SQSGASNY

SEQ ID NO: 2197 - protein, 15 aa, Artificial Sequence
  Description of Artificial Sequence: Synthetic polypeptide
NTPSGTTTQSRLQFS

SEQ ID NO: 2198 - protein, 19 aa, Artificial Sequence
  Description of Artificial Sequence: Synthetic polypeptide
TSADNNNSEYSWTGATKYH

SEQ ID NO: 2199 - protein, 8 aa, Artificial Sequence
  Description of Artificial Sequence: Synthetic polypeptide
SASGASNF

SEQ ID NO: 2200 - protein, 19 aa, Artificial Sequence
  Description of Artificial Sequence: Synthetic polypeptide
TDGENNNSDFSWTGATKYH

SEQ ID NO: 2201 - protein, 8 aa, Artificial Sequence
  Description of Artificial Sequence: Synthetic polypeptide
SASGASNY

SEQ ID NO: 2202 - protein, 19 aa, Artificial Sequence
  Description of Artificial Sequence: Synthetic polypeptide
TSADNNNSEFSWPGATTYH

SEQ ID NO: 2203 - protein, 15 aa, Artificial Sequence
  Description of Artificial Sequence: Synthetic polypeptide
NTPSGSLTQSSLGFS

SEQ ID NO: 2204 - protein, 19 aa, Artificial Sequence
  Description of Artificial Sequence: Synthetic polypeptide
TSADNNNSDFSWTGATKYH

SEQ ID NO: 2205 - protein, 8 aa, Artificial Sequence
  Description of Artificial Sequence: Synthetic polypeptide
SGAGASNF

SEQ ID NO: 2206 - DNA, 48 bp, Artificial Sequence
  Description of Artificial Sequence: Synthetic oligonucleotide
  misc_feature (20)..(20): a, c, t, or g
  misc_feature (35)..(35): a, c, t, or g
ctccagvvsvvsmrsrvcvnsgcagctdhcvvsrnsgtcvmsacacaa

SEQ ID NO: 2207 - DNA, 48 bp, Artificial Sequence
  Description of Artificial Sequence: Synthetic oligonucleotide
ctccagagaggcaacagacaagcagctaccgcagatgtcaacacacaa

SEQ ID NO: 2208 - protein, 7 aa, Artificial Sequence
  Description of Artificial Sequence: Synthetic polypeptide
SAAGASN

SEQ ID NO: 2209 - protein, 24 aa, Artificial Sequence
  Description of Artificial Sequence: Synthetic polypeptide
YFLSRTNTESGSTTQSTLRFSQAG

SEQ ID NO: 2210 - protein, 13 aa, Artificial Sequence
  Description of Artificial Sequence: Synthetic polypeptide
SKTSADNNNSDFS

SEQ ID NO: 2211 - protein, 14 aa, Artificial Sequence
  Description of Artificial Sequence: Synthetic polypeptide
KQGSEKTDVDIDKV

SEQ ID NO: 2212 - protein, 7 aa, Artificial Sequence
  Description of Artificial Sequence: Synthetic polypeptide
STAGASN

SEQ ID NO: 2213 - protein, 24 aa, Artificial Sequence
  Description of Artificial Sequence: Synthetic polypeptide
YFLSRTNTTSGIETQSTLRFSQAG

SEQ ID NO: 2214 - protein, 13 aa, Artificial Sequence
  Description of Artificial Sequence: Synthetic polypeptide
SKTDGENNNSDFS

SEQ ID NO: 2215 - protein, 14 aa, Artificial Sequence
  Description of Artificial Sequence: Synthetic polypeptide
KQGAAADDVEIDGV

SEQ ID NO: 2216 - protein, 7 aa, Artificial Sequence
  Description of Artificial Sequence: Synthetic polypeptide
SEAGASN

SEQ ID NO: 2217 - protein, 24 aa, Artificial Sequence
  Description of Artificial Sequence: Synthetic polypeptide
YYLSRTNTPSGTTTQSRLQFSQAG

SEQ ID NO: 2218 - protein, 13 aa, Artificial Sequence
  Description of Artificial Sequence: Synthetic polypeptide
SKTSADNNNSEYS

SEQ ID NO: 2219 - protein, 14 aa, Artificial Sequence
  Description of Artificial Sequence: Synthetic polypeptide
KQGSEKTNVDIEKV

SEQ ID NO: 2220 - protein, 24 aa, Artificial Sequence
  Description of Artificial Sequence: Synthetic polypeptide
YFLSRTNDASGSDTKSTLLFSQAG

SEQ ID NO: 2221 - protein, 13 aa, Artificial Sequence
  Description of Artificial Sequence: Synthetic polypeptide
STTPSENNNSEYS

SEQ ID NO: 2222 - protein, 7 aa, Artificial Sequence
  Description of Artificial Sequence: Synthetic polypeptide
SAAGATN

SEQ ID NO: 2223 - protein, 24 aa, Artificial Sequence
  Description of Artificial Sequence: Synthetic polypeptide
YFLSRTNGEAGSATLSELRFSQAG

SEQ ID NO: 2224 - protein, 8 aa, Artificial Sequence
  Description of Artificial Sequence: Synthetic polypeptide
HGDDADRF

SEQ ID NO: 2225 - protein, 14 aa, Artificial Sequence
  Description of Artificial Sequence: Synthetic polypeptide
KQGAEKSDVEVDRV

SEQ ID NO: 2226 - protein, 14 aa, Artificial Sequence
  Description of Artificial Sequence: Synthetic polypeptide
KQDSGGDNIDIDQV

SEQ ID NO: 2227 - protein, 7 aa, Artificial Sequence
  Description of Artificial Sequence: Synthetic polypeptide
SDAGASN

SEQ ID NO: 2228 - protein, 24 aa, Artificial Sequence
  Description of Artificial Sequence: Synthetic polypeptide
YFLSRTNTEGGHDTQSTLRFSQAG

SEQ ID NO: 2229 - protein, 14 aa, Artificial Sequence
  Description of Artificial Sequence: Synthetic polypeptide
KEDGGGSDVAIDEV

SEQ ID NO: 2230 - protein, 7 aa, Artificial Sequence
  Description of Artificial Sequence: Synthetic polypeptide
SNAGASN

SEQ ID NO: 2231 - protein, 24 aa, Artificial Sequence
  Description of Artificial Sequence: Synthetic polypeptide
YFLSRTNGEAGSATLSELRFSQPG

SEQ ID NO: 2232 - DNA, 21 bp, Artificial Sequence
  Description of Artificial Sequence: Synthetic oligonucleotide
agcvvmdcaggarscascaac

SEQ ID NO: 2233 - DNA, 18 bp, Artificial Sequence
  Description of Artificial Sequence: Synthetic oligonucleotide
aacracrrsmrsmaggca

SEQ ID NO: 2234 - DNA, 24 bp, Artificial Sequence
  Description of Artificial Sequence: Synthetic oligonucleotide
cacrrggacrrcrmsrrsarsttt

SEQ ID NO: 2235 - DNA, 75 bp, Artificial Sequence
  Description of Artificial Sequence: Synthetic oligonucleotide
  misc_feature (35)..(35): a, c, t, or g
tatttcttgagcagaacaaacrvcvvsrscggamncvhsacgmhstcavvscttvdsttttctcagsbcrgsgcg

SEQ ID NO: 2236 - DNA, 48 bp, Artificial Sequence
  Description of Artificial Sequence: Synthetic oligonucleotide
  misc_feature (11)..(11): a, c, t, or g
tcaamammavnsrvcsrsaacaacaacagtrasttctcgtggmmagga

SEQ ID NO: 2237 - DNA, 42 bp, Artificial Sequence
  Description of Artificial Sequence: Synthetic oligonucleotide
  misc_feature (31)..(31): a, c, t, or g
aagsaarrcrscrvsrvarvcratrycgmsnhcrvmvrsgtc

SEQ ID NO: 2238 - DNA, 42 bp, Artificial Sequence
  Description of Artificial Sequence: Synthetic oligonucleotide
  misc_feature (17)..(17): a, c, t, or g
  misc_feature (32)..(32): a, c, t, or g
cagvvsvvsmrsrvcvnsgcagctdhcvvsrnsgtcvmsaca

SEQ ID NO: 2239 - DNA, 33 bp, Artificial Sequence
  Description of Artificial Sequence: Synthetic oligonucleotide
aactwcrvsvasmvsvhsddtgtgswstksact

SEQ ID NO: 2240 - DNA, 30 bp, Artificial Sequence
  Description of Artificial Sequence: Synthetic polynucleotide
ttgttgaacatcaccacgtgacgcacgttc

SEQ ID NO: 2241 - DNA, 30 bp, Artificial Sequence
  Description of Artificial Sequence: Synthetic polynucleotide
tccccgtggttctactacataatgtggccg

SEQ ID NO: 2242 - DNA, 30 bp, Artificial Sequence
  Description of Artificial Sequence: Synthetic polynucleotide
ttccacactccgttttggataatgttgaac

SEQ ID NO: 2243 - DNA, 30 bp, Artificial Sequence
  Description of Artificial Sequence: Synthetic polynucleotide
agggacatccccagctccatgctgtggtcg

SEQ ID NO: 2244 - DNA, 30 bp, Artificial Sequence
  Description of Artificial Sequence: Synthetic polynucleotide
agggacaacccctccgactcgccctaatcc

SEQ ID NO: 2245 - DNA, 30 bp, Artificial Sequence
  Description of Artificial Sequence: Synthetic polynucleotide
tcctagtagaagacaccctctcactgcccg

SEQ ID NO: 2246 - DNA, 30 bp, Artificial Sequence
  Description of Artificial Sequence: Synthetic polynucleotide
agtaccatgtacacccactctcccagtgcc

SEQ ID NO: 2247 - DNA, 30 bp, Artificial Sequence
  Description of Artificial Sequence: Synthetic polynucleotide
atatggacgttcatgctgatcaccataccg

SEQ ID NO: 2248 - DNA, 30 bp, Artificial Sequence
  Description of Artificial Sequence: Synthetic polynucleotide
agcaggagctccttggcctcagcgtgcgag

SEQ ID NO: 2249 - DNA, 30 bp, Artificial Sequence
  Description of Artificial Sequence: Synthetic polynucleotide
acaagcagcttcactatgacaaccactgac

SEQ ID NO: 2250 - DNA, 284 bp, Artificial Sequence
  Description of Artificial Sequence: Synthetic polynucleotide
  misc_feature (59)..(59): n is a, c, g, or t
  misc_feature (244)..(244): n is a, c, g, or t
cagcctaggaactggcttcctggaccctgttaccgccagcagagagtctcaamammavnsrvcsrsaacaacaacagtrasttctcctggmmaggagctaccaagtaccacctcaatggcagagactctctggtgaatcccggaccagctatggcaagccacrrggacrrcrmsrrsarsttttttcctcagagcggggttctcatctttgggaagsaarrcrscrvsrvarvcratrycgmsnhcrvmvrsgtcatgattacagacgaagaggagatctggac

SEQ ID NO: 2251 - DNA, 34 bp, Artificial Sequence
  Description of Artificial Sequence: Synthetic polynucleotide
tgggacaatggcggtcgtctctcagagttktkkt

SEQ ID NO: 2252 - DNA, 35 bp, Artificial Sequence
  Description of Artificial Sequence: Synthetic polynucleotide
agaggacckktcctcgatggttcatggtggagtta

SEQ ID NO: 2253 - DNA, 31 bp, Artificial Sequence
  Description of Artificial Sequence: Synthetic polynucleotide
ccacttagggcctggtcgataccgttcggtg

SEQ ID NO: 2254 - DNA, 32 bp, Artificial Sequence
  Description of Artificial Sequence: Synthetic polynucleotide
tctcgccccaagagtagaaacccttcsttyyg

SEQ ID NO: 2255 - protein, 735 aa, Adeno-associated virus 2 [sequence omitted]

SEQ ID NO: 2256 - protein, 736 aa, Adeno-associated virus 9; identical to SEQ ID NO: 123

SEQ ID NO: 2257 - protein, 7 aa, Artificial Sequence
  Description of Artificial Sequence: Synthetic polypeptide
GSTPPPM

SEQ ID NO: 2258 - protein, 7 aa, Artificial Sequence
  Description of Artificial Sequence: Synthetic polypeptide
GETRAPL

SEQ ID NO: 2259 - protein, 6 aa, Artificial Sequence
  Description of Artificial Sequence: Synthetic polypeptide
SPAKFA

SEQ ID NO: 2260 - protein, 6 aa, Artificial Sequence
  Description of Artificial Sequence: Synthetic polypeptide
NKDKLN
